United States Patent 11,959,108 (ENGINEERED PROTEASE VARIANTS) - sequence listing, part 2

SEQ ID NO: 1529 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgactctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1530 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1531 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1532 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1533 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggagaccagcaccctgagtctggcgatcgcgaacaccgacctgatcaagagcattaaagtgagcgttgacatcgaacacacttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1534 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLSLAIANTDLIKSIKVSVDIEHTYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1535 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattttgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcggtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacccgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagttag

SEQ ID NO: 1536 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSGVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDPIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1537 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1538 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSGVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1539 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtagtgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagttag

SEQ ID NO: 1540 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRSAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINKGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDTGKMRSFTLELGFEQPS

SEQ ID NO: 1541 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtagtgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattttgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccggattag

SEQ ID NO: 1542 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRSAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVGVDIEHSYIGDLVVTLKAPVEMGVDPILLHNREGAATDNIKKTYDVVNAPGLAACKGKSPQGTWALEVADKVQRDIGKMRSFTLELGFEQPD

SEQ ID NO: 1543 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtggaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1544 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWWNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1545 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaagttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1546 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQEEADAFVWAAQNGADVISCSWGPPDGVWYNPWDPRHNQKVPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1547 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggcggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1548 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQAEADAFVWAAQNGADVISCSWGPPDGVWYNPWDPRHNQVFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1549 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggccagcggtctgggcagccaggaggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1550 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1551 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggccagcggtctgggcagccaggaggaagcggatgcgtttgtttgggcggcgcaaaacggtgcggatgttattagctgcagctggggtccgccggacggtgtttggtggaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1552 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWWNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1553 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctgggcgctggaagttgccgataaagtgcagcgtgacattggcaagatgcgtagctttaccctggaactgggctttgagcaaccgagctag

SEQ ID NO: 1554 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1555 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttggtatgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1556 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWYEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1557 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatcgctaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1558 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIATIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1559 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatcgttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1560 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIVTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1561 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactggattttgagcaaccgagctag

SEQ ID NO: 1562 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELDFEQPS

SEQ ID NO: 1563 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatgtttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1564 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSMFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1565 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgcgtatagcgatttcggcaacgcggtttggtgcgcgtttccgagcaacgacggccgtcctagcaaaaccccgggtatttggaccaccgatcgtatgggccgtgtgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1566 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRVGYNRGNLRQGDAAGNYTNSFGGTSSACPGAAGVAALIIARNPNLRWDEVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1567 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggcggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1568 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQAEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1569 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcatggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtcacattggcaagatgcgtagctttaccctggaactgggctttgagcaaccgagctag

SEQ ID NO: 1570 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSMVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRHIGKMRSFTLELGFEQPS

SEQ ID NO: 1571 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagctgtcagggtacctggaccctggaagttgccgataaagtgcagcgtgacattggcaagatgcgtagctttaccctggaactgggctttgagcaaccgagctag

SEQ ID NO: 1572 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSCQGTWTLEVADKVQRDIGKMRSFTLELGFEQPS

SEQ ID NO: 1573 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1574 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1575 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtgtatagcgatttcggcaacgcggtttggtgcgcgtttccgagcaacgacggccgtcctagcaaaaccccgggtatttggaccaccgatcgtatgggccgtgtgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcacagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggacgctggaagttgccgataaagtgcagcgtgacattggcaagatgcgtagctttaccctggaactgggctttgagcaaccgagctag

SEQ ID NO: 1576 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRVGYNRGNLRQGDAAGNYTNSFGGTSSACPGAAGVAALIIARNPNLRWDEVREIIKQSCDRIDQQGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWTLEVADKVQRDIGKMRSFTLELGFEQPS

SEQ ID NO: 1577 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgttcgggccgtgtgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagccggtggcaactacgatgcgagtggtcgcagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctgggcgctggaagttgccgataaagtgcagcgtgacattggcaagatgcgtagctttaccctggaactgggctttgagcaaccgagctag

SEQ ID NO: 1578 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRSGRVGYNRGNLRQGDAAGNYTNSFGGTSSACPGAAGVAALIIARNPNLRWDEVREIIKQSCDRIDQAGGNYDASGRSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKVQRDIGKMRSFTLELGFEQPS

SEQ ID NO: 1579 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagccggtggcaactacgatgcgagtggtcacagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggacgctggaagttgccgataaagtgcagcgtgacattggcaagatgcgtagctttaccctggaactgggctttgagcaaccgagctag

SEQ ID NO: 1580 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWTLEVADKVQRDIGKMRSFTLELGFEQPS

SEQ ID NO: 1581 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1582 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1583 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1584 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1585 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacagggtggcaactacgatgcgagtggtcgcagcccgttctacggttatggccgtatgaacgcgcgtaaggcggtggaactggcgatgccggagtggcctagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgccgataaagcgcagcgtgacattggcaagatgcgtagctttaccctggaactgggctttgagcaaccgagctag

SEQ ID NO: 1586 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQQGGNYDASGRSPFYGYGRMNARKAVELAMPEWPSPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKAQRDIGKMRSFTLELGFEQPS

SEQ ID NO: 1587 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1588 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWTLEVADKVQRDIGKMRSFTLELGFEQPS

SEQ ID NO: 1589 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaggctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1590 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSRLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1591 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgaaccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1592 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLNQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWTLEVADKVQRDIGKMRSFTLELGFEQPS

SEQ ID NO: 1593 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcacagcccgttctacggttatggccgtatgaacgcgcgtaaggcggtggaactggcgatgccggagtggcctagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgccgataaagtgcagcgtgacattggcaagatgcgtagctttaccctggaactgggctttgagcaaccgagctag

SEQ ID NO: 1594 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQQGGNYDASGHSPFYGYGRMNARKAVELAMPEWPSPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1595 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaatgatccgcgtcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagccggtggcaactacgatgcgagtggtcgcagcccgttctacggttatggccgtatgaacgcgcgtaaggcggtggaactggcgatgccggagtggcctagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctggacgctggaagttgccgataaagtgcagcgtgacattggcaagatgcgtagctttaccctggaactgggctttgagcaaccgagctag

SEQ ID NO: 1596 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1597 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtagttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1598 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQEEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPS

SEQ ID NO: 1599 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggaggaagcggatgcgtttgtttgggcggcgcaaaacggtgcggatgttattagctgcagctggggtccgccggacggtgtttggtggaacccgtgggatccgcgccacaaccagaaagttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1600 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQEEADAFVWAAQNGADVISCSWGPPDGVWWNPWDPRHNQKVPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPS

SEQ ID NO: 1601 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtgtgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1602 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRVGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1603 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaataaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaatgatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcacagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1604 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQQGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1605 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcatggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggcggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1606 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEIMERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQAEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1607 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1608 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1609 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcacccataccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1610 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTHTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1611 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcacctcgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1612 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTSTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1613 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacggtgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1614 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANGDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1615 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggcctagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1616 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1617 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1618 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1619 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggcggaagcggatgcgtttgtttgggcggcgcaaaacggtgcggatgttattagctgcagctggggtccgccggacggtgtttggtggaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1620 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQAEADAFVWAAQNGADVISCSWGPPDGVWWNPWDPRHNQKFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPS

SEQ ID NO: 1621 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggccagcggtctgggcagccaggaggaagcggatgcgtttgtttgggcggcgcaaaacggtgcggatgttattagctgcagctggggtccgccggacggtgtttggtggaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1622 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWWNPWDPRHNQVFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPS

SEQ ID NO: 1623 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtggaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1624 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWWNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPS

SEQ ID NO: 1625 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggcggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1626 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQAEADAFVWAAQNGADVISCSWGPPDGVWYNPWDPRHNQVFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1627 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgttcgggccgtctgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcgcagcccgttctacggttatggccgtatgaacgcgcgtaaggcggtggaactggcgatgccggagtgggaaagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1628 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRSGRLGYNRGNLRQGDAAGNYTNSFGGTSSACPGAAGVAALIIARNPNLRWDEVREIIKQSCDRIDQQGGNYDASGRSPFYGYGRMNARKAVELAMPEWESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1629 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcgcagcccgttctacggttatggccgtatgaacgcgcgtaaggcggtggaactggcgatgccggagtgggaaagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1630 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQQGGNYDASGRSPFYGYGRMNARKAVELAMPEWESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1631 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttagtatttttacgatcgtgcaggacgttccgattaaagatctggaaaccagcaccctgaccctggcgatcgcgaacaccgacctgatcaagagcattaaagtgagcgttgacatcgaacacagttatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1632 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1633 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtagttttacgatcgtgcaggacgttccgattaaagatctggaaaccagcaccctgaccctggcgatcgcgaacaccgacctgatcaagagcattaaagtgagcgttgacatcgaacacagtcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1634 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSSFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1635 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagttatcgcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1636 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSIFTIVQDVPIKDLETSTLTLAIANTDLIKSIKVSVDIEHSYRGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1637 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1638 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1639 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcagggggcaactacgatgcgagtggtcatagcccgttctacggttatggccgtatgaacgcgcgtaaggcgggggaactggcgatgccggagtggccaagcccggttagtatttttaccatcgtgcaggacgttccgattaaagatctggaaaccagcaccctgaccctggcgatcgcgaacaccgacctgatcaagatcattaaagtgagcgttgacatcgaacactgcgtcgtcggcgatctggtggttgccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1640 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAGELAMPEWPSPVSIFTIVQDVPIKDLETSTLTLAIANTDLIKIIKVSVDIEHCVVGDLVVALKAPVEMGVDPMLLHNREGAATDNIKKTYDVVNAPGLAACKGKSPQGTWTLEVADKVQRDIGKMRSFTLELGFEQPS

SEQ ID NO: 1641 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgaccgtatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggttggtggcaaccgagctag

SEQ ID NO: 1642 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDRIKSIKVSVDIEHSYIGDLVVTLKAPVEMGVDPMLLHNREGAATDNIKKTYDVVNAPGLAACKGKSPQGTWTLEVADKVQRDIGKMRSFTLELGWWQPS

SEQ ID NO: 1643 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcatgttctacggttatggccgtatgaacgcgcgtaaggcggtggaactggcgatgccggagtggccaagcgaagttagtatctttaccatcgtgcaggacgttccgattaaagatctggagaccagcaccctgaccctggcgatcgcgaacaccgaccgtatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1644 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSMFYGYGRMNARKAVELAMPEWPSEVSIFTIVQDVPIKDLETSTLTLAIANTDRIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1645 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggagagcccggttagtatttttacgatcgtgcaggacgttccgattaaagatctggaaaccagcaccctgaccctggcgatcgcgaacaccgacctgatcaagagcattaaagtgagcgttgacatcgaacacagtcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1646 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWESPVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1647 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcgaagttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1648 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSEVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1649 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgccccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1650 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1651 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttattattggcacgatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1652 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVIIGTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1653 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttagtatttttacgatcgtgcaggacgttccgattaaagatctggaaaccagcaccctgaccctggcgatcgcgaacaccgacctgatcaagagcattaaagtgagcgttgacatcgaacacagctacatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1654 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1655 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacgggggcaagatgcgtagctttaccctggaactgggctttgagcaaccgagctag

SEQ ID NO: 1656 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDGGKMRSFTLELGFEQPS

SEQ ID NO: 1657 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgtggcgtgacattggcaagatgcgtagctttaccctggaactgggctttgagcaaccgagctag

SEQ ID NO: 1658 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVWRDIGKMRSFTLELGFEQPS

SEQ ID NO: 1659 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagttatcgcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1660 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYRGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1661 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcatgttctatggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1662 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSMFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1663 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagtgtgatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1664 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSVIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1665 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtattggcacgatcgtgcaggacgttccgattaaagatctggaaaccagcaccctgaccctggcgatcgcgaacaccgacctgatcaagagcattaaagtgagcgttgacatcgaacacagtcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1666 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSIGTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1667 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagaggccgagctag

SEQ ID NO: 1668 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1669 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagccctgttagtatctttaccatcgtgcaggacgttccgattaaagatctggaaaccagcaccagcaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1670 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTSTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1671 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagccctgttagtatctttaccatcgtgcaggacgttccgattaaagatctggagaccagcaccagcaccctggcgatcgcgaacaccgaccgtatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1672 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTSTLAIANTDRIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1673 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgttgcgtgacattggcaagatgcgtagctttaccctggaactgggctttgagcaaccgagctag

SEQ ID NO: 1674 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVLRDIGKMRSFTLELGFEQPS

SEQ ID NO: 1675 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttagtagttttacgatcgtgcaggacgttccgattaaagatctggaaaccagcaccctgaccctggcgatcgcgaacaccgacctgatcaagagcattaaagtgagcgttgacatcgaacacagtcgtcgcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1676 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVSSFTIVQDVPIKDLETSTLTLAIANTDLIKSIKVSVDIEHSRRGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1677 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgggccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1678 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDGPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1679 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcagagggttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1680 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQRVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1681 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttagtatttttacgatcgtgcaggacgttccgattaaagatctggaaaccagcaccctgaccctggcgatcgcgaacaccgacctgatcaagagcattaaagtgagcgttgacatcgaacacagtgtgatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1682 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVSIFTIVQDVPIKDLETSTLTLAIANTDLIKSIKVSVDIEHSVIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1683 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatttttctgatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1684 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSIFLIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1685 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggagagcccggttagtattggcacgatcgtgcaggacgttccgattaaagatctggaaaccagcaccctgaccctggcgatcgcgaacaccgacctgatcaagagcattaaagtgagcgttgacatcgaacacagtcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1686 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWESPVSIGTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1687 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtagttttctgatcgtgcaggacgttccgattaaagatctggaaaccagcaccctgaccctggcgatcgcgaacaccgacctgatcaagagcattaaagtgagcgttgacatcgaacaccgttatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1688 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSSFLIVQDVPIKDLETSTLTLAIANTDLIKSIKVSVDIEHRYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1689 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggagagcccggttagtagttttctgatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1690 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWESPVSSFLIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1691 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccgggtagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1692 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPGSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1693 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcgaagttagtatctttaccatcgtgcaggacgttccgattaaagatctggaaaccagcaccctgaccctggcgatcgcgaacaccgaccgtatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggtttcgaacaaccgagctag

SEQ ID NO: 1694 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSEVSIFTIVQDVPIKDLETSTLTLAIANTDRIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1695 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtattggcctgatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1696 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIGLIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1697 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcatgttctacggttatggccgtatgaacgcgcgtaaggcggtggaactggcgatgccggagtggccaagcgaagttagtatctttaccatcgtgcaggacgttccgattaaagatctggggaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1698 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSMFYGYGRMNARKAVELAMPEWPSEVSIFTIVQDVPIKDLGTSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1699 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgacagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1700 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDDSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1701 - DNA, 2001 bp, Artificial Sequence
  Variant of serine endopeptidase from Microcoleus sp. PCC 7113
atggtgactgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgacagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacacccgcctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1702 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDDSGHSPFYGYGRMNARKAVELAMPEWPSPVSIFTIVQDVPIKDLETSTLTLAIANTRLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1703 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgacagtggtcatagcccgttctacggttatggccgtatgaacgcgcgtaaggcggtggaactggcgatgccggagtggccaagcctggttagtattgccaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1704 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDDSGHSPFYGYGRMNARKAVELAMPEWPSLVSIATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1705 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtattgccaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1706 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1707 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcacgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtgagggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggcttcgaacaaccgagctag

SEQ ID NO: 1708 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLREGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1709 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgacagtggtcatagcccgttctacggttatggccgtatgaacgcgcgtaaggcggtggaactggcgatgccggagtggccaagcccggttagtatttttaccatcgtgcaggacgttccgattaaagatctggaaaccagcaccctgaccctggcgatcgcgaacaccgaccgcatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1710 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDDSGHSPFYGYGRMNARKAVELAMPEWPSPVSIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1711 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcccggttagtatttttaccatcgtgcaggacgttccgattaaagatctggaaaccagcaccctgaccctggcgatcgcgaacacccgcctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1712 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTRLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1713 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcctggttagtatttttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1714 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSLVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1715 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcccggttagtctggccaccatcgtgcaggacgttccgattaaagatctggaaaccagcaccctgaccctggcgatcgcgaacaccgaccgcatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1716 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSLATIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1717 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgttgcgcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcccggttagtatttttaccatcgtgcaggacgttccgattaaagatctggaaaccagcaccctgaccctggcgatcgcgaacacccgccgcatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1718 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRCAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTRRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1719 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgttgcgcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcccggttagtattgccaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1720 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRCAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1721 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcctggttagtattgccaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1722 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSLVSIATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1723 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcctggttagtattgacaccatcgtgcaggacgttccgattaaagatctggaaaccagcaccctgaccctggcgatcgcgaacacccgcctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1724 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSLVSIDTIVQDVPIKDLETSTLTLAIANTRLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1725 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1726 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1727 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1728 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1729 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaatcgtagcgccctgatggagactcgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1730 - protein, 666 aa, Artificial Sequence
  Variant of serine endopeptidase from Microcoleus sp. PCC 7113
MVTVRYGGRNGEPYELTISDEHIVVRTENRSALMETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1731 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaaccgtagcatcctgaccgaaacccgtccgtacgaggtgacctcggttagcccggaggcgcgtagcatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1732 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARSILDQFELETRFRAAGVEILRAKDPREDSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1733 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaatcgtagcatcctgaccgaaacccgtccgtacgaggtgacctcggttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1734 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPREDSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1735 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctacacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcaaccgagctag

SEQ ID NO: 1736 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1737 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccggtcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccattgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcaaccgagctag

SEQ ID NO: 1738 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPVPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1739 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagcatttttaccattgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagctag

SEQ ID NO: 1740 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1741 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1742 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1743 - DNA, 2001 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1744 - protein, 666 aa, Artificial Sequence
  Variant of serine endopeptidase from Microcoleus sp. PCC 7113
MVTVRYGGKNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1745 - DNA, 2001 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1746 - protein, 666 aa, Artificial Sequence
  Variant of serine endopeptidase from Microcoleus sp. PCC 7113
MVTVRYGGKNGEPYELTISDEHIVVRTENRSILTETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1747 - DNA, 2001 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaatcgtagcgccctgacggagactcgtccgtacgaggtgaccagcgttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctggggtacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1748 - protein, 666 aa, Artificial Sequence
  Variant of serine endopeptidase from Microcoleus sp. PCC 7113
MVTVRYGGKNGEPYELTISDEHIVVRTENRSALTETRPYEVTSVSPEARNILDQFELETRFRAAGVEILRAKDPREDSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1749 - DNA, 2001 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagagtcgtagcattctgacggggactcgtccgtacgaggtgaccccggttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtgtctttaccatcgtgcaggacgttccgattaaagatatggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1750 - protein, 666 aa, Artificial Sequence
  Variant of serine endopeptidase from Microcoleus sp. PCC 7113
MVTVRYGGKNGEPYELTISDEHIVVRTESRSILTGTRPYEVTPVSPEARNILDQFELETRFRAAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSVFTIVQDVPIKDMETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1751 - DNA, 2001 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgacctcggttagcccggaggcgcgtagcatcctggaccagttcgagctggaaacccgttttcgtgaggcgggtgtggagattctgcgtgcgaaggacccgcgtgaaaacagcgcgctccgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1752 - protein, 666 aa, Artificial Sequence
  Variant of serine endopeptidase from Microcoleus sp. PCC 7113
MVTVRYGGKNGEPYELTISDEHIVVRTENRSILTETRPYEVTSVSPEARSILDQFELETRFREAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1753 - DNA, 2001 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgaccccggttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1754 - protein, 666 aa, Artificial Sequence
  Variant of serine endopeptidase from Microcoleus sp. PCC 7113
MVTVRYGGKNGEPYELTISDEHIVVRTENRSILTETRPYEVTPVSPEARNILDQFELETRFRAAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1755 - DNA, 2001 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1756 - protein, 666 aa, Artificial Sequence
  Variant of serine endopeptidase from Microcoleus sp. PCC 7113
MVTVRYGGKNGEPYELAISDEHIVVRTENRSILTETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1757 - DNA, 2001 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaaccgtagcatcctgaccgaaacccgtccgtacgaggtgaccagcgttagcccggaggcgcgtagcatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1758 - protein, 666 aa, Artificial Sequence
  Variant of serine endopeptidase from Microcoleus sp. PCC 7113
MVTVRYGGKNGEPYELAISDEHIVVRTENRSILTETRPYEVTSVSPEARSILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1759 - DNA, 2001 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaatcgtagcattctgatggggactcgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatatggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1760 - protein, 666 aa, Artificial Sequence
  Variant of serine endopeptidase from Microcoleus sp. PCC 7113
MVTVRYGGKNGEPYELAISDEHIVVRTENRSILMGTRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDMETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1761 - DNA, 2001 bp, Artificial Sequence
  Variant of serine endopeptidase from Microcoleus sp. PCC 7113
atggtgaccgtgcgttatggcggccagaatggtgaaccgtatgaactggcgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatatttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1762 - protein, 666 aa, Artificial Sequence
  Variant of serine endopeptidase from Microcoleus sp. PCC 7113
MVTVRYGGQNGEPYELAISDEHIVVRTENRSILTETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1763 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaaccgtagcatcctgaccgaaacccgtccgtacgaggtgaccccggttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1764 - protein, 666 aa, Artificial Sequence
  Variant of serine endopeptidase from Microcoleus sp. PCC 7113
MVTVRYGGRNGEPYELTISDEHIVVRTENRSILTETRPYEVTPVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1765 - DNA, 2001 bp, Artificial Sequence
  Variant of serine endopeptidase from Microcoleus sp. PCC 7113
atggtgaccgtgcgttatggcggccgtaatggtgaaccgtatgaactggcgatcagcgacgagcatattgttgtgcgtaccgagaatcgtagcgccctgatggggactcgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1766 - protein, 666 aa, Artificial Sequence
  Variant of serine endopeptidase from Microcoleus sp. PCC 7113
MVTVRYGGRNGEPYELAISDEHIVVRTENRSALMGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1767 - DNA, 2001 bp, Artificial Sequence
  Variant of serine endopeptidase from Microcoleus sp. PCC 7113
atggtgaccgtgcgttatggcggccgtaatggtgaaccgtatgaactggcgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1768 - protein, 666 aa, Artificial Sequence
  Variant of serine endopeptidase from Microcoleus sp. PCC 7113
MVTVRYGGRNGEPYELAISDEHIVVRTENRSILTETRPYEVTSVSPEARNILDQFELETRFRAAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1769 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagcctggcgaccattgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagctag

SEQ ID NO: 1770 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSLATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1771 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcctggttcgcatttttaccattgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgcagcgtgacattggcaagatgcgtagctttaccctggaactgggctttgagcagccgagctag

SEQ ID NO: 1772 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSLVRIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADSVQRDIGKMRSFTLELGFEQPS

SEQ ID NO: 1773 - DNA, 2001 bp, Artificial Sequence
  Variant of serine endopeptidase from Microcoleus sp. PCC 7113
atggtgaccgtgcgttatggcggccgtaatggtgaaccgtatgaactggcgatcagcgacgagcatattgttgtgcgtaccgagagtcgtagcattctgatgggggatcgtccgtacgaggtgaccagcgttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1774 - protein, 666 aa, Artificial Sequence
  Variant of serine endopeptidase from Microcoleus sp. PCC 7113
MVTVRYGGRNGEPYELAISDEHIVVRTESRSILMGDRPYEVTSVSPEARNILDQFELETRFRAAGVEILRAKDPREDSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1775 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaatcgtagcattctgaccgaaacccgtccgtacgaggtgacctcggttagcccggaggcgcgtagcatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1776 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARSILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1777 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcaaccgagctag

SEQ ID NO: 1778 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1779 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgcagcgtgacattggcaagatgcgtagctttaccctggaactgggctttgagcaaccgagctag

SEQ ID NO: 1780 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADSVQRDIGKMRSFTLELGFEQPS

SEQ ID NO: 1781 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1782 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1783 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgttgcgcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgcagcgtgacattggcaagatgcgtagctttaccctggaactgggctttgagcaaccgagctag

SEQ ID NO: 1784 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRCAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADSVQRDIGKMRSFTLELGFEQPS

SEQ ID NO: 1785 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcggcgaccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1786 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIAATDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1787 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaacccgaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaaccccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1788 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNPKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPTPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1789 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccattgtgcaggacgttccgattaaagatctggaaaccagcaccctgaccctggcgatcgcgaatacccgtcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcaaccgagctag

SEQ ID NO: 1790 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTRRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1791 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttcgcctggcgaccattgtgcaggacgttccgattaaagatctggaaaccagcaccctgaccctggcgatcgcggcgaccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgtggcgtgacattggcaagatgcgtagctttaccctggaactgggctttgagcagccgagctag

SEQ ID NO: 1792 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVRLATIVQDVPIKDLETSTLTLAIAATDLIKSIKVSVDIEHLRIGDLVVTLKAPVEMGVDPMLLHNREGAATDNIKKTYDVVNAPGLAACKGKSPQGTWTLEVADSVWRDIGKMRSFTLELGFEQPS

SEQ ID NO: 1793 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaatacccgtcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgcagcgtgacattggcaagatgcgtagctttaccctggaactgggctttgagcagccgagctag

SEQ ID NO: 1794 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTRRIKSIKVSVDIEHLRIGDLVVTLKAPVEMGVDPMLLHNREGAATDNIKKTYDVVNAPGLAACKGKSPQGTWTLEVADSVQRDIGKMRSFTLELGFEQPS

SEQ ID NO: 1795 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccctcgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgtggcgtgacattggcaagatgcgtagctttaccctggaactgggctttgagcgcccgagctag

SEQ ID NO: 1796 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTLVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADSVWRDIGKMRSFTLELGFERPS

SEQ ID NO: 1797 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcctggttagcctgtttaccattgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgtggcgtgacattggcaagatgcgtagctttaccctggaactgggctttgagcgcccgagctag

SEQ ID NO: 1798 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWDEVREIIKQSCDRIDQAGGNYDASGHSPFYGYGRMNARKAVELAMPEWPSLVSLFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADSVWRDIGKMRSFTLELGFERPS

SEQ ID NO: 1799 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagcatttttaccattgtgcaggacgttccgattaaagatctggaaaccagcaccctgaccctggcgatcgcgaatacccgtcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1800 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWDEVREIIKQSCDRIDQAGGNYDASGHSPFYGYGRMNARKAVELAMPEWPSPVSIFTIVQDVPIKDLETSTLTLAIANTRRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1801 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgtggcgtgacattggcaagatgcgtagctttaccctggaactgggctttgagcagccgagctag

SEQ ID NO: 1802 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVWRDIGKMRSFTLELGFEQPS

SEQ ID NO: 1803 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1804 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1805 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgttgcgcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgtggcgtgacattggcaagatgcgtagctttaccctggaactgggctttgagcaaccgagctag

SEQ ID NO: 1806 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRCAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADSVWRDIGKMRSFTLELGFEQPS

SEQ ID NO: 1807 - DNA, 2001 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgacctcggttagcccggaggcgcgtaacatcctggaccagttcgagctggaaacccgttttcgtgaggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcaagcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1808 - protein, 666 aa, Artificial Sequence
  Variant of serine endopeptidase from Microcoleus sp. PCC 7113
MVTVRYGGKNGEPYELTISDEHIVVRTENRSILTETRPYEVTSVSPEARNILDQFELETRFREAGVEILRAKDPRENSALRDTARVILNQEPEIQFAGRVLVDPQSKQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1809 - DNA, 2001 bp, Artificial Sequence
  Variant of serine endopeptidase from Microcoleus sp. PCC 7113
atggtgaccgtgcgttatggcggccgtaatggtgaaccgtatgaactggcgatcagcgacgagcatattgttgtgcgtaccgagagtcgtagcgccctgatggaggatcgtccgtacgaggtgaccagcgttagcccggaggcgcgtaacatcctggaccagttcgagctggaaacccgttttcgtgaggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1810 - protein, 666 aa, Artificial Sequence
  Variant of serine endopeptidase from Microcoleus sp. PCC 7113
MVTVRYGGRNGEPYELAISDEHIVVRTESRSALMEDRPYEVTSVSPEARNILDQFELETRFREAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1811 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaatcgtagcgccctgaccgaaacccgtccgtacgaggtgaccccggttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1812 - protein, 666 aa, Artificial Sequence
  Variant of serine endopeptidase from Microcoleus sp. PCC 7113
MVTVRYGGRNGEPYELTISDEHIVVRTENRSALTETRPYEVTPVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1813 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaaccgtagcattctgacggggactcgtccgtacgaggtgacctcggttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctggagtacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1814 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELEYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1815 - DNA, 2001 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgaccccggttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcagtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1816 - protein, 666 aa, Artificial Sequence
  Variant of serine endopeptidase from Microcoleus sp. PCC 7113
MVTVRYGGKNGEPYELTISDEHIVVRTENRSILTETRPYEVTPVSPEARNILDQFELETRFRAAGVEILRAKDPRENSALRDTARVILNQEPEIQFAGRVLVDPQSMQPVVYTENIFVKFDDETQSSACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1817 - DNA, 2001 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaatcgtagcgccctgatggaggatcgtccgtacgaggtgaccagcgttagcccggaggcgcgtagcatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcaagcaaccggtggtttacaccgagaacatcttcgtgaagtttgacgatgaaacccagagcagtgcgtgccaagagatcctggaacgttatggcctgaccattaaacgtgagctggggtacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1818 - protein, 666 aa, Artificial Sequence
  Variant of serine endopeptidase from Microcoleus sp. PCC 7113
MVTVRYGGKNGEPYELAISDEHIVVRTENRSALMEDRPYEVTSVSPEARSILDQFELETRFRAAGVEILRAKDPREDSALRDTARVILNQEPAIQFAGRVLVDPQSKQPVVYTENIFVKFDDETQSSACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1819 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccggtcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgtggcgtgacattggcaagatgcgtagctttaccctggaactgggctttgagcagccgagctag

SEQ ID NO: 1820 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPVPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVWRDIGKMRSFTLELGFEQPS

SEQ ID NO: 1821 - DNA, 2001 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagagtcgtagcattctgatggggactcgtccgtacgaggtgacctcggttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctggggtacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1822 - protein, 666 aa, Artificial Sequence
  Variant of serine endopeptidase from Microcoleus sp. PCC 7113
MVTVRYGGRNGEPYELTISDEHIVVRTESRSILMGTRPYEVTSVSPEARNILDQFELETRFRAAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1823 - DNA, 2001 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgaggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagctag

SEQ ID NO: 1824 - protein, 666 aa, Artificial Sequence
  Variant of serine endopeptidase from Microcoleus sp. PCC 7113
MVTVRYGGKNGEPYELAISDEHIVVRTENRSILTETRPYEVTSVSPEARNILDQFELETRFREAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1825 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaaattcagcgtgacattggcaagatgcgtagctttaccctggaactgggctttgagcgcccgagctag

SEQ ID NO: 1826 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKIQRDIGKMRSFTLELGFERPS

SEQ ID NO: 1827 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaaatgcagcgtgacattggcaagatgcgtagctttaccctggaactgggctttgagcgcccgagctag

SEQ ID NO: 1828 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKMQRDIGKMRSFTLELGFERPS

SEQ ID NO: 1829 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtgtgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1830 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRVGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1831 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgattcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1832 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDSAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1833 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaaaggcagcgtgacattggcaagatgcgtagctttaccctggaactgggctttgagcgcccgagctag

SEQ ID NO: 1834 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKRQRDIGKMRSFTLELGFERPS

SEQ ID NO: 1835 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatttggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1836 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDLAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1837 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatatggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1838 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDMAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1839 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgaggaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1840 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPRNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1841 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgttatattggcaagatgcgtagctttaccctggaactgggctttgagcgcccgagctag

SEQ ID NO: 1842 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRYIGKMRSFTLELGFERPS

SEQ ID NO: 1843 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtatttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1844 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGIWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1845 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtgagcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1846 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGERDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1847 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacccgcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1848 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINPRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1849 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtggtcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1850 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGGRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1851 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacgctcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1852 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINARQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1853 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtacgattggcaagatgcgtagctttaccctggaactgggctttgagcgcccgagctag

SEQ ID NO: 1854 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRTIGKMRSFTLELGFERPS

SEQ ID NO: 1855 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatctggaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctggggagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1856 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREIWKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1857 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacattcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1858 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINIRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1859 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcttgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1860 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTILQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1861 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggttggcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1862 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGWRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1863 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagctggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggctgagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggacgctggaagttgccgataaagtgcagcgtgacattggcaagatgcgtagctttaccctggaactgggctttgagcgcccgagctag

SEQ ID NO: 1864 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPAEMGVDPMLLHNREGAATDNIKKTYDVVNAPGLAACKGKSPQGTWTLEVADKVQRDIGKMRSFTLELGFERPS

SEQ ID NO: 1865 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaactgcagcgtgacattggcaagatgcgtagctttaccctggaactgggctttgagcgcccgagctag

SEQ ID NO: 1866 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKLQRDIGKMRSFTLELGFERPS

SEQ ID NO: 1867 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtttgcgtgataaccatggtaccgcgtgcgcgggtgtggcgtgcgcgaacggtaaagttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1868 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGLRDNHGTACAGVACANGKVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1869 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggttatcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1870 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGYRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1871 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtgttcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1872 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGVRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1873 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtctgcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1874 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGLRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1875 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtatgcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1876 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGMRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1877 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtagtcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1878 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGSRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1879 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtgcgcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1880 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1881 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagctggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcgaactgaccctggcgatcgcgaataccgatctgatcaagagcattaaagtgagcgttgtcatcgaacacctgcgtatcggcgatctggtggttaccctgaaggcgccggctgagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1882 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSELTLAIANTDLIKSIKVSVVIEHLRIGDLVVTLKAPAEMGVDPMLLHNREGAATDNIKKTYDVVNAPGLAACKGKSPQGTWTLEVADKVQRDIGKMRSFTLELGFERPS

SEQ ID NO: 1883 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcgcccgagctag

SEQ ID NO: 1884 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1885 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaggcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1886 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGRRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1887 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagtttcgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1888 - protein, 666 aa, Artificial Sequence
  Variant of serine endopeptidase from Microcoleus sp. PCC 7113
MVTVRYGGRNGEPYELTISDEHIVVRTEFRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1889 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaatatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgtcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagctatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagctag

SEQ ID NO: 1890 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1891 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaagggaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1892 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREGNKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1893 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgaggggcgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1894 - protein, 666 aa, Artificial Sequence
  Variant of serine endopeptidase from Microcoleus sp. PCC 7113
MVTVRYGGRNGEPYELTISDEHIVVRTEGRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1895 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgtgtagctttaccctggaactgggctttgagcgcccgagctag

SEQ ID NO: 1896 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMCSFTLELGFERPS

SEQ ID NO: 1897 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgagacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgcgtcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagctag

SEQ ID NO: 1898 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1899 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgtcgatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1900 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLSIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1901 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgacacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1902 - protein, 666 aa, Artificial Sequence
  Variant of serine endopeptidase from Microcoleus sp. PCC 7113
MVTVRYGGRNGEPYELTISDEHIVVRTENRSILTDTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1903 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgtagcatcctgaccgagacccgtccgtacgaggtgaccagcgttagcccggaggcgcgtagtatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1904 - protein, 666 aa, Artificial Sequence
  Variant of serine endopeptidase from Microcoleus sp. PCC 7113
MVTVRYGGRNGEPYELTISDEHIVVRTESRSILTETRPYEVTSVSPEARSILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1905 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtagtatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgtcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 1906 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARSILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1907 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgcgataaccatggtaccgcgtgcgcgggtgtggcgtgcgcgaacggtaacgttggtgcgagcggtgttgcgccgggtgcggccctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgccctgggttacaaccgtggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgcgcggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1908 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGAALMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDASGHSPFYGYGRMNARAAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1909 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgagacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaagaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgtatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1910 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLYIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1911 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1912 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSLVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1913 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttaccctgaagaccaacgacccgcgtccgggtaaccgcgataaccatggtaccgcgtgcgcgggtgtggcgtgcgcgaacggtaacgttggtgcgagcggtgttgcgccgggtgcgcgcctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgcaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1914 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTLKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1915 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgtcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1916 - protein, 666 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1917 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1918 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1919 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcctgaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcacgatgcgtagctttaccctggaactgggctttgagcgcccgagctag

SEQ ID NO: 1920 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSLTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGTMRSFTLELGFERPS

SEQ ID NO: 1921 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctggggatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1922 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLGIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1923 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacacgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1924 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYTRNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1925 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcactaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1926 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREITKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1927 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcacgatgcgtagctttaccctggaactgggctttgagcgcccgagctag

SEQ ID NO: 1928 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGTMRSFTLELGFERPS

SEQ ID NO: 1929 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgcgtcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1930 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1931 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattcagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1932 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIQKTYDVVNAPGLAACKGKSPQGTWTLEVADKVQRDIGKMRSFTLELGFERPS

SEQ ID NO: 1933 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccgtggtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1934 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTVVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1935 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggctatatgcgtagctttaccctggaactgggctttgagcgcccgagctag

SEQ ID NO: 1936 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGYMRSFTLELGFERPS

SEQ ID NO: 1937 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcggccctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1938 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGAALMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1939 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggccagatgcgtagctttaccctggaactgggctttgagcgcccgagctag

SEQ ID NO: 1940 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGQMRSFTLELGFERPS

SEQ ID NO: 1941 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggccttatgcgtagctttaccctggaactgggctttgagcgcccgagctag

SEQ ID NO: 1942 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGLMRSFTLELGFERPS

SEQ ID NO: 1943 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1944 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1945 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgtttcacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1946 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPFHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1947 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcggtgaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1948 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNAVKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1949 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcgtggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1950 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEIVERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1951 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagtggccgagctag

SEQ ID NO: 1952 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEWPS

SEQ ID NO: 1953 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgccctgggttacaaccgtggtaacctgcgccagggtgatgcggcgggtaactataccaacagctttggtggcaccagcagctcgtgccaaggtgcggcgggagtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1954 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1955 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgagacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggcagaagcggatgcgtttgtttgggcggcgcaaaacggtgcggatgttattagctgcagctggggtccgccggacggtgtttggtacaacccgtgggatccgctgcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagctatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 1956 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQAEADAFVWAAQNGADVISCSWGPPDGVWYNPWDPLHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1957 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggattctggaagttgccgataaagtgcagcgtgacattggcaagatgcgtagctttaccctggaactgggctttgagcgcccgagctag

SEQ ID NO: 1958 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWILEVADKVQRDIGKMRSFTLELGFERPS

SEQ ID NO: 1959 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaatatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaagaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 1960 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1961 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcaggacattggcaagatgcgtagctttaccctggaactgggctttgagcgcccgagctag

SEQ ID NO: 1962 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQQDIGKMRSFTLELGFERPS

SEQ ID NO: 1963 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggtggacattggcaagatgcgtagctttaccctggaactgggctttgagcgcccgagctag

SEQ ID NO: 1964 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQVDIGKMRSFTLELGFERPS

SEQ ID NO: 1965 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1966 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1967 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1968 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1969 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgaggggccgagctag

SEQ ID NO: 1970 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEGPS

SEQ ID NO: 1971 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatggggtgcagcgtgacattggcaagatgcgtagctttaccctggaactgggctttgagcgcccgagctag

SEQ ID NO: 1972 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADGVQRDIGKMRSFTLELGFERPS

SEQ ID NO: 1973 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagacgctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1974 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQETLERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1975 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtcgtgcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1976 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARRAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1977 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgcctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccgtggtaacctgcgccagggtgatgcggcgggtaactataccaacagctttggtggcaccagcagctcgtgccaaggtgcggcgggtgtggcggcgctgatcattgcggtaaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgcaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1978 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIAVNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1979 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttggggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1980 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVGACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1981 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgctgcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagctatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagctag

SEQ ID NO: 1982 - protein, 666 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1983 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagggcagcgtgacattggcaagatgcgtagctttaccctggaactgggctttgagcgcccgagctag

SEQ ID NO: 1984 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKGQRDIGKMRSFTLELGFERPS

SEQ ID NO: 1985 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaatttggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1986 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQFGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1987 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgaggtgccgagctag

SEQ ID NO: 1988 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEVPS

SEQ ID NO: 1989 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1990 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDEVNAPGLAACKGKSPQGTWTLEVADKVQRDIGKMRSFTLELGFERPS

SEQ ID NO: 1991 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatgaggtgcagcgtgacattggcaagatgcgtagctttaccctggaactgggctttgagcgcccgagctag

SEQ ID NO: 1992 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADEVQRDIGKMRSFTLELGFERPS

SEQ ID NO: 1993 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgagacccgtccgtacgaggtgaccagcgttagcccggaggcgcgtagtatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgctgcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggatttgagcgcccgagctag

SEQ ID NO: 1994 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARSILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1995 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 1996 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 1997 - DNA, 2001 bp, Artificial Sequence; identical to SEQ ID NO: 1833
  Variant of serine endopeptidase from Microcoleus sp. PCC 7113

SEQ ID NO: 1998 - protein, 666 aa, Artificial Sequence; identical to SEQ ID NO: 1834
  Variant of serine endopeptidase from Microcoleus sp. PCC 7113

SEQ ID NO: 1999 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2000 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2001 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccctggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcacgatgcgtagctttaccctggaactgggctttgagcgcccgagctag

SEQ ID NO: 2002 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNPGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGTMRSFTLELGFERPS

SEQ ID NO: 2003 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacgcgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2004 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHARIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2005 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgagtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2006 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2007 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtcataccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2008 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRHTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2009 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggagctggaagttgccgataaagtgcagcgtgacattggcaagatgcgtagctttaccctggaactgggctttgagcgcccgagctag

SEQ ID NO: 2010 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWELEVADKVQRDIGKMRSFTLELGFERPS

SEQ ID NO: 2011 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaataccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2012 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRNTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2013 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtgctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2014 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2015 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaaatgggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2016 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQMGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2017 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcatctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2018 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRHLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2019 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagcatccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2020 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEHPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2021 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgattgggtgcagcgtgacattggcaagatgcgtagctttaccctggaactgggctttgagcgcccgagctag

SEQ ID NO: 2022 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADWVQRDIGKMRSFTLELGFERPS

SEQ ID NO: 2023 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtgatgcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2024 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARDAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2025 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagcggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2026 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPERPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2027 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgccctgggttacaaccctggtaacctgcgtcagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgctgaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2028 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNPGNLRQGDAAGNYTNSFGGTSSSCQGAAGVAALIIARNPNLRWEEVREIIKQSCDRIDQAGGNYDASGHSPFYGYGRMNALKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2029 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggaactggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtgttgcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2030 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVELDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARVAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2031 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcatctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagctag

SEQ ID NO: 2032 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRHLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDEVNAPGLAACKGKSPQGTWVLEVADKVQRDIGKMRSFTLELGFERPS

SEQ ID NO: 2033 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcatctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagctag

SEQ ID NO: 2034 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRHLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWVLEVADKVQRDIGKMRSFTLELGFERPS

SEQ ID NO: 2035 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2036 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2037 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccgggggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2038 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPGARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2039 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcctgaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2040 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREILKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2041 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaaccagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacggcggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2042 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINQRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNGGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2043 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtcacaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgttccacaatcaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgctgcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctatggttatggccgtatgaacgcgcgcaaggcggtggaactggcgatgccggagtggccaagcctggttagtatctttaccattgtgcaggacgttccgattaaagatctggaaaccagcaccctgaccctggcgatcgcgaataccgatctgatcaagagcattaaagtgagcgttgacatcgaacacagcagcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcaggacattggcaagatgcgtagctttaccctggaactgggctttgagcgcccgagctag

SEQ ID NO: 2044 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRHTNDPRPGNRDNHGTACAGVACANGNVGASGVAPGARLMPIRFVSGLGSQEEADAFVWAAQNGADVISCSWGPPDGVWYNPWDPFHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSSIGDLVVTLKAPVEMGVDPMLLHNREGAATDNIKKTYDVVNAPGLAACKGKSPQGTWTLEVADKVQQDIGKMRSFTLELGFERPS

SEQ ID NO: 2045 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcccgaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2046 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSPTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2047 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtgaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2048 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNAREAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2049 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtcttgcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2050 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARLAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2051 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtatggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2052 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARMAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2053 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtagggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2054 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARRAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2055 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtactgcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2056 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARTAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2057 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2058 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2059 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaccgtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2060 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSITVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2061 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaccacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2062 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPS

SEQ ID NO: 2063 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggccagagcccgcagggtacctggaccctggaagttgccgataaagtgcagcgtgacattggcaagatgcgtagctttaccctggaactgggctttgagcgtccgagctag

SEQ ID NO: 2064 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGQSPQGTWTLEVADKVQRDIGKMRSFTLELGFERPS

SEQ ID NO: 2065 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgttccacaatcaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaggcggtggaactggcgatgccggagtggccaagcctggttagtatctttaccgttgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2066 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPFHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTVVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2067 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgttccacaatcaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgctgcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcggtaaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2068 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPFHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNAVKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEGPS

SEQ ID NO: 2069 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgttccacaatcaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagcggcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2070 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPFHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSGIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2071 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatccgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2072 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2073 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtgtgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2074 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRVNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2075 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatccgtagctttaccctggaactgggctttgagcgtccgagctag

SEQ ID NO: 2076 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKIRSFTLELGFERPS

SEQ ID NO: 2077 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagctag

SEQ ID NO: 2078 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDEVNAPGLAACKGKSPQGTWVLEVADKVQRDIGKMRSFTLELGFERPS

SEQ ID NO: 2079 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggatcctggaagttgccgataaagtgcagcgtgacattggcaagatgcgtagctttaccctggaactgggctttgagcgtccgagctag

SEQ ID NO: 2080 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWILEVADKVQRDIGKMRSFTLELGFERPS

SEQ ID NO: 2081 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcagggtacctggatcctggaagttgccgataaagtgcagcgtgacattggcaagatgcgtagctttaccctggaactgggctttgagcgtccgagctag

SEQ ID NO: 2082 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDEVNAPGLAACKGKSPQGTWILEVADKVQRDIGKMRSFTLELGFERPS

SEQ ID NO: 2083 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtctgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgcactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2084 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGLRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2085 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcatctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggatcctggaagttgccgataaagtgcagcgtgacattggcaagatgcgtagctttaccctggaactgggctttgagcgtccgagctag

SEQ ID NO: 2086 - protein, 666 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRHLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWILEVADKVQRDIGKMRSFTLELGFERPS

SEQ ID NO: 2087 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgcactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2088 - protein, 666 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2089 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2090 - protein, 666 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2091 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtctgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgcactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2092 - protein, 666 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGLRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDEVNAPGLAACKGKSPQGTWTLEVADKVQRDIGKMRSFTLELGFERPS

SEQ ID NO: 2093 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagctag

SEQ ID NO: 2094 - protein, 666 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWVLEVADKVQRDIGKMRSFTLELGFERPS

SEQ ID NO: 2095 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagtcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2096 - protein, 666 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2097 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaactggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2098 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQELAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2099 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaagagtatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2100 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILEEYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2101 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttagtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2102 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFSTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2103 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgcactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2104 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2105 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2106 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2107 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagctag

SEQ ID NO: 2108 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWVLEVADKVQRDIGKMRSFTLELGFERPS

SEQ ID NO: 2109 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgacgccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2110 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2111 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaacggggataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2112 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNGDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2113 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaacgggagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2114 - protein, 666 aa, Artificial Sequence
  Variant of serine endopeptidase from Microcoleus sp. PCC 7113
MVTVRYGGRNGEPYELTISDEHIVVRTENGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2115 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggaccctgccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2116 - protein, 666 aa, Artificial Sequence
  Variant of serine endopeptidase from Microcoleus sp. PCC 7113
MVTVRYGGRNGEPYELTISDEHIVVRTENRSILTGTLPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2117 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgagctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2118 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGELGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2119 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcggtgaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2120 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIAVNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2121 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccagatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2122 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDQIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2123 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcggaaaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2124 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNAEKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2125 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagcttcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2126 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSFIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2127 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagctag

SEQ ID NO: 2128 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQADIGKMRSFTLELGFERPS

SEQ ID NO: 2129 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatggtgagctttaccctggaactgggctttgagcgtccgagctag

SEQ ID NO: 2130 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMVSFTLELGFERPS

SEQ ID NO: 2131 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgaatgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2132 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPNENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2133 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2134 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2135 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgaacgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2136 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALNDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2137 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgctggttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2138 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTALVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2139 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2140 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2141 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacacgcgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2142 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHTRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2143 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagctag

SEQ ID NO: 2144 - protein, 666 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQADIGKMRSFTLELGFERPS

SEQ ID NO: 2145 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtctggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2146 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARLAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2147 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2148 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2149 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2150 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2151 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcctgaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2152 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREILKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPS

SEQ ID NO: 2153 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtctggcggtggaactggcgatgccggagtggccaagcctggttagtatctttaccatcgtgcaggacgttccgattaaagatctggaaaccagcaccctgaccctggcgatcgcgaataccgatccgatcaagagcattaaggtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2154 - protein, 666 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARLAVELAMPEWPSLVSIFTIVQDVPIKDLETSTLTLAIANTDPIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2155 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcggtcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2156 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIAVNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPS

SEQ ID NO: 2157 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaggtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2158 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPS

SEQ ID NO: 2159 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagcggcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcggtcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagagcagcgtgacattggcaagatgcgtagctttaccctggaactgggctttgagcgtccgagctag

SEQ ID NO: 2160 - protein, 666 aa, Artificial Sequence
  Variant of serine endopeptidase from Microcoleus sp. PCC 7113
MVTVRYGGRNGEPYELTISDEHIVVRTESGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIAVNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKEQRDIGKMRSFTLELGFERPS

SEQ ID NO: 2161 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcctgaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2162 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREILKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2163 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagcggcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2164 - protein, 666 aa, Artificial Sequence
  Variant of serine endopeptidase from Microcoleus sp. PCC 7113
MVTVRYGGRNGEPYELTISDEHIVVRTESGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2165 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2166 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2167 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagcggcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagctag

SEQ ID NO: 2168 - protein, 666 aa, Artificial Sequence
  Variant of serine endopeptidase from Microcoleus sp. PCC 7113
MVTVRYGGRNGEPYELTISDEHIVVRTESGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQADIGKMRSFTLELGFERPS

SEQ ID NO: 2169 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaagacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2170 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2171 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2172 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPS

SEQ ID NO: 2173 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatccgatcgagagcattaaggtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagctag

SEQ ID NO: 2174 - protein, 666 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIESIKVSVDIEHSRIGDLVVTLKAPVEMGVDPMLLHNREGAATDNIKKTYDVVNAPGLAACKGKSPQGTWTLEVADKVQADIGKMRSFTLELGFERPS

SEQ ID NO: 2175 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgtcgcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2176 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPS

SEQ ID NO: 2177 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagcggcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgtcgcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaagacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2178 - protein, 666 aa, Artificial Sequence
  Variant of serine endopeptidase from Microcoleus sp. PCC 7113
MVTVRYGGRNGEPYELTISDEHIVVRTESGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2179 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgtcgcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtacggcggtggaactggcgatgccggagtggccaagcctggttagtatctttaccatcgtgcaggacgttccgattaaagatctggaaaccagcaccctgaccctggcgatcgcgaataccgatctgatcaagagcattaaggtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2180 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARTAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2181 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgagtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcggtcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagctag

SEQ ID NO: 2182 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTASKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIAVNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQADIGKMRSFTLELGFERPS

SEQ ID NO: 2183 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2184 - protein, 666 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2185 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgtcgcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcccaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccgttgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2186 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSPTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTVVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2187 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtaagcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2188 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2189 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatttggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2190 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2191 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaatgtagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2192 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIECSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2193 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcgaggaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2194 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGARTDNIKKTYDVVNAPGLAACKGKSPQGTWTLEVADKVQRDIGKMRSFTLELGFERPS

SEQ ID NO: 2195 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcagagtgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2196 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQSVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2197 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccggcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2198 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2199 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcgggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2200 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2201 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2202 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFERPS

SEQ ID NO: 2203 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagcctggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2204 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSLEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2205 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggtgtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2206 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPVWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2207 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgaccaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2208 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLTNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2209 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtaaacgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgttcaggacgttccgattaaagatctggaaaccagcaccctgaccctggcgatcgcgaataccgatccgatcaaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2210 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2211 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatattgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2212 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDIAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2213 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctgaccctgggctttgagcgtccgagctag

SEQ ID NO: 2214 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLTLGFERPS

SEQ ID NO: 2215 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaatgtagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2216 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIECSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2217 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtttgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgttcaggacgttccgattaaagatctggaaaccagcaccctgaccctggcgatcgcgaataccgatctgatcgaaagcattaaagtgagcgttgacatcgaatgtagccgcatcggcgatctggtggttaccctgaaggcgccggtggagatgggcgttgatccgatgctgctgcataaccgtgagggtgcgcgcaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggagctgggctttgagcgtccgagctag

SEQ ID NO: 2218 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIESIKVSVDIECSRIGDLVVTLKAPVEMGVDPMLLHNREGARTDNIKKTYDVVNAPGLAACKGKSPQGTWTLEVADKVQRDIGKMRSFTLELGFERPS

SEQ ID NO: 2219 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2220 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2221 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaatgtagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggagctgggctttgagcgtccgagctag

SEQ ID NO: 2222 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIECSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2223 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2224 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2225 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgattatggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcttgcaggacgttccgattaaagatatggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2226 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDYGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTILQDVPIKDMETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2227 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaaacggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2228 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQANGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2229 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcggtgaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2230 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAVNADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2231 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcattagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2232 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSISNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2233 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattttctttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2234 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2235 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagccaaggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2236 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSQGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2237 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaacagggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2238 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQQGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2239 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccacgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2240 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2241 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgccgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcctaaccgtgagggtgcgcgcaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2242 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLPNREGARTDNIKKTYDVVNAPGLAACKGKSPQGTWTLEVADKVQRDIGKMRSFTLELGFERPS

SEQ ID NO: 2243 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtaaacgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2244 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2245 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggaactgggctttgagcgtccgagctag

SEQ ID NO: 2246 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2247 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccagagtgttccgattaaagatctggaaaccagcaccctgaccctggcgatcgcgaataccgatccgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggagctgggctttgagcgtccgagctag

SEQ ID NO: 2248 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQSVPIKDLETSTLTLAIANTDPIKSIKVSVDIEHSRIGDLVVTLKAPVEMGVDPMLLPNREGAATDNIKKTYDVVNAPGLAACKGKSPQGTWTLEVADKVQRDIGKMRSFTLELGFERPS

SEQ ID NO: 2249 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctgaccctgggctttgagcgtccgagctag

SEQ ID NO: 2250 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLTLGFERPS

SEQ ID NO: 2251 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgccgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcaaaagcattaaagtgagcgttgacatcgaatgtagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcaggctgacattggcaagatgcgtagctttaccctggaactgggctttgagcgtccgagctag

SEQ ID NO: 2252 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIECSRIGDLVVTLKAPVEMGVDPMLLHNREGAATDNIKKTYDVVNAPGLAACKGKSPQGTWTLEVADKVQADIGKMRSFTLELGFERPS

SEQ ID NO: 2253 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtaaacgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaatgtagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2254 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIECSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2255 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatttttaccatcgttcaggacgttccgattaaagatctggaaaccagcaccctgaccctggcgatcgcgaataccgatccgatcaaaagcattaaagtgagcgttgacatcgaacacagccgcatcggcgatgtggtggttaccctgaaggcgccggtggagatgggcgttgatccgatgctgctgcataaccgtgagggtgcgcgcaccgacaacattaagaaaacctatgatgtagtgaacgcgccgggtctggcggcgtgcaagggcaaaagcccgcagggtacctggaccctggaagttgccgataaagtgcaggctgacattggcaagatgcgtagctttaccctgaccctgggctttgagcgtccgagctag

SEQ ID NO: 2256 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIKSIKVSVDIEHSRIGDVVVTLKAPVEMGVDPMLLHNREGARTDNIKKTYDVVNAPGLAACKGKSPQGTWTLEVADKVQADIGKMRSFTLTLGFERPS

SEQ ID NO: 2257 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgttcagagtgttccgattaaagatctggaaaccagcaccctgaccctggcgatcgcgaataccgatccgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggctgacattggcaagatgcgtagctttaccctggagctgggctttgagcgtccgagctag

SEQ ID NO: 2258 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQSVPIKDLETSTLTLAIANTDPIKSIKVSVDIEHSRIGDLVVTLKAPVEMGVDPMLLPNREGAATDNIKKTYDVVNAPGLAACKGKSPQGTWTLEVADKVQADIGKMRSFTLELGFERPS

SEQ ID NO: 2259 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgccgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccagagtgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcataaccgtgagggtgcgcgcaccgacaacattaagaaaacctatgatgtagtgaacgcgccgggtctggcggcgtgcaagggcaaaagcccgcagggtacctggaccctggaagttgccgataaagtgcaggctgacattggcaagatgcgtagctttaccctggagctgggctttgagcgtccgagctag

SEQ ID NO: 2260 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIRQSVPIKDLETSTLTLAIANTDLIKSIKVSVDIEHSRIGDLVVTLKAPVEMGVDPMLLHNREGARTDNIKKTYDVVNAPGLAACKGKSPQGTWTLEVADKVQADIGKMRSFTLELGFERPS

SEQ ID NO: 2261 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggagctgggctttgagcgtccgagctag

SEQ ID NO: 2262 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFERPS

SEQ ID NO: 2263 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgttcaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2264 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGRAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIESIKVSVDIEHSRIGDLVVTLKAPVEMGVDPMLLPNREGAATDNIKKTYDVVNAPGLAACKGKSPQGTWTLEVADKVQRDIGKMRSFTLELGFERPS

SEQ ID NO: 2265 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtaaacgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgccgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggaactgggctttgagcgtccgagctag

SEQ ID NO: 2266 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPTPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFERPS

SEQ ID NO: 2267 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccattatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2268 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTIIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2269 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccgtgatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2270 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTVIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2271 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacgcccgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcaaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgcgacattggcaagatgcgtagctttaccctggaactgggctttgagcgtccgagctag

SEQ ID NO: 2272 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINARQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDPIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2273 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacgcccgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2274 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINARQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2275 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaagccgaccaccatccgtggtcaggcgattaacgcgagtgcgaacgtggaagcggcgtggagcctgagcaacggtaccggtaccgtgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatccgatcaaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagtggccgagctag

SEQ ID NO: 2276 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTVIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDPIKSIKVSVDIEHSGIGDLVVTLKAPVEMGVDPMLLHNREGAATDNIKKTYDVVNAPGLAACKGKSPQGTWTLEVADKVQRDIGKMRSFTLELGFEWPS

SEQ ID NO: 2277 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2278 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS

SEQ ID NO: 2279 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2280 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2281 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2282 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFEGPS

SEQ ID NO: 2283 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaagccgaccaccatccgtggtcaggcgattaacgcgagtgcgaacgtggaagcggcgtggagcctgagcaacggtaccggtaccgtgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2284 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTVIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2285 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtatgggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaacccctggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagctag

SEQ ID NO: 2286 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGMGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2287 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaggtgcagcgcgacattggcgtaatgcgtagctttaccctggaactgggctttgagggcccgagctag

SEQ ID NO: 2288 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIMKTYDVVNAPGLAACKGKSPQGTWTLEVADKVQRDIGVMRSFTLELGFEGPS

SEQ ID NO: 2289 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaagccgaccaccatccgtggtcaggcgattaacgcgagtgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2290 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2291 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2292 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2293 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggccaaagcccgcagggtacctggaccctggaagttgccgataaagtgcagcgtgacattggcaagatgcgtagctttaccctggaactgggctttgagcgtccgagctag

SEQ ID NO: 2294 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGQSPQGTWTLEVADKVQRDIGKMRSFTLELGFERPS

SEQ ID NO: 2295 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgtggccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2296 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLWPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS

SEQ ID NO: 2297 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgtggccgaccaccatccgtggtcaggcgattaacgcgagtgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2298 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLWPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2299 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaacccctggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggccaaagcccgcagggtacctggaccctggaagttgccgataaggtgcagcgcgacattggcaagatgcgtagctttaccctggaactgggctttgagcgtccgagctag

SEQ ID NO: 2300 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIKKTYDVVNAPGLAACKGQSPQGTWTLEVADKVQRDIGKMRSFTLELGFERPS

SEQ ID NO: 2301 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtatgggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2302 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGMGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2303 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2304 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLPNREGAATDNIKKTYDVVNAPGLAACKGKSPQGTWTLEVADKVQRDIGKMRSFTLELGFEGPS

SEQ ID NO: 2305 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcggagaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2306 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNAEKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2307 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagtggccgagctag

SEQ ID NO: 2308 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFEWPS

SEQ ID NO: 2309 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgtggccgaccaccatccgtggtcaggcgattaacgcggatgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagtggccgagctag

SEQ ID NO: 2310 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLWPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFEWPS

SEQ ID NO: 2311 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2312 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2313 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaagccgaccaccatccgtggtcaggcgattaacgcgagtgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaactttggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2314 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTPGIWTTDRMGVLGYNFGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2315 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgtggccgaccaccatctcgggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagctag

SEQ ID NO: 2316 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLWPTTISGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPS

SEQ ID NO: 2317 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtatatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcgtagcccgttctacggttatggccgtatgaacgcgcgtaaagcggtggaactggcgatgccggagtgggaaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2318 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGRSPFYGYGRMNARKAVELAMPEWESLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS

SEQ ID NO: 2319 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtatatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtgggaaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2320 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWESLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS

SEQ ID NO: 2321 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgcatatagcgatttcggcaacgcggtttggtgcgcgtttccgagcaacgacggccgtcctagcaaaaccactggtatttggaccaccgatcgtagcggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccgagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2322 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSAYSDFGNAVWCAFPSNDGRPSKTTGIWTTDRSGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS

SEQ ID NO: 2323 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtatatagcgatttcggcaacgcggtttggtgcgcgtttccgagcaacgacggccgtcctagcaaaaccactggtatttggaccaccgatcgtagcggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcgtagcccgttctacggttatggccgtatgaacgcgcgtaaagcggtggaactggcgatgccggagtggccgagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2324 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRSGVLGYNRGNLRQGDLAGNYTNSFGGTSSSCQGAAGVAALIIASNPNLRWEEVREIIKQSCDRIDQAGGNYDSSGRSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS

SEQ ID NO: 2325 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtatatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcgtagcccgttctacggttatggccgtatgaacgcgcgtaaagcggtggaactggcgatgccggagtggccgagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2326 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGRSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS

SEQ ID NO: 2327 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgcggtggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2328 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCGGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS

SEQ ID NO: 2329 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgcgggggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctag

SEQ ID NO: 2330 - protein, 666 aa, Artificial Sequence; identical to SEQ ID NO: 2328
  Variant of serine endopeptidase from Microcoleus sp. PCC 7113

SEQ ID NO: 2331 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgcccgggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagctaa

SEQ ID NO: 2332 - protein, 666 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCPGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPS
